United States Patent 11,931,406 (FLAVIVIRUS VACCINE) - sequence listing, part 25

SEQ ID NO: 10714 - RNA, 9879 nt, Artificial Sequence
  derived and/or modified CDS sequence (opt2) from DENV-1__KF955427__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgccuggaccggcgccaccgagauccagaccuccggcaccaccaccaucuucgccggccaccucaaguggcgccucaagauggacaagcucacccucaagggcaccuccuacgucaugugcaccggcuccuucaagcucgagaaggaggucgccgagacccagcacggcaccggccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccuccccgacccccucaucgccggcggcauccucaucgccugcuacgucaucuccggcuccuccgccgaccucucccucgagaaggccgccgagauguccugggagcaggaggccgagcacuccggcaccucccacaacauccucgucgagguccaggacgacggccccaugaagaucaaggacgaggagcgcgacgacacccucaccauccuccucaaggccacccuccucgccgucuccggcgucuaccccauguccauccccggcacccucuucgucugguacuucuggcagaagaagaagcagcgcuccggcguccucugggacacccccuccccccccaaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10715 - RNA, 9879 nt, Artificial Sequence
  derived and/or modified CDS sequence (opt2) from DENV-1__GQ868513__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcccaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaucacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10716 - RNA, 9879 nt, Artificial Sequence
  derived and/or modified CDS sequence (opt2) from DENV-1__GU131973__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10717 - RNA, 9879 nt, Artificial Sequence
  derived and/or modified CDS sequence (opt2) from DENV-1__GQ868517__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10718 - RNA, 9879 nt, Artificial Sequence
  derived and/or modified CDS sequence (opt2) from DENV-1__GU131976__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccucccucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccucaaggcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10719 - RNA, 9879 nt, Artificial Sequence
  derived and/or modified CDS sequence (opt2) from DENV-1__GQ868518__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggccccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccgcggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucaccucccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10720 - RNA, 9879 nt, Artificial Sequence
  derived and/or modified CDS sequence (opt2) from DENV-1__GQ868519__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaucacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10721 - RNA, 9879 nt, Artificial Sequence
  derived and/or modified CDS sequence (opt2) from DENV-1__KF955443__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagauguccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuuccucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggacccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10722 - RNA, 9879 nt, Artificial Sequence
  derived and/or modified CDS sequence (opt2) from DENV-1__GQ868520__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10723 - RNA, 9879 nt, Artificial Sequence
  derived and/or modified CDS sequence (opt2) from DENV-1__GQ868522__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaucacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcaggcccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10724 - RNA, 9879 nt, Artificial Sequence
  derived and/or modified CDS sequence (opt2) from DENV-1__HQ166036__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccgcggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucaccucccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10725 - RNA, 9879 nt, Artificial Sequence
  derived and/or modified CDS sequence (opt2) from DENV-1__GU131981__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucauggucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaucacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10726 - RNA, 9879 nt, Artificial Sequence
  derived and/or modified CDS sequence (opt2) from DENV-1__GQ868529__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaccguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaucgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucaugcucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccucggccacgaggaccccauccccauggccaccuacggcuggaaccucgucaagcuccucgccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10727 - RNA, 9879 nt, Artificial Sequence
  derived and/or modified CDS sequence (opt2) from DENV-1__GQ868531__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucuccuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10728 - RNA, 9879 nt, Artificial Sequence
  derived and/or modified CDS sequence (opt2) from DENV-1__GU131983__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaucggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgaggagaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10729 - RNA, 9879 nt, Artificial Sequence
  derived and/or modified CDS sequence (opt2) from DENV-1__GQ868532__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaucacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcaacuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggccccccccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucacccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccaacgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacggcauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10730 - RNA, 9879 nt, Artificial Sequence
  derived and/or modified CDS sequence (opt2) from DENV-1__GQ868533__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucgaggccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuuccucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucaccucccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgccaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaaguccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10731 - RNA, 9879 nt, Artificial Sequence
  derived and/or modified CDS sequence (opt2) from DENV-1__GQ868534__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaagaacgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10732 - RNA, 9879 nt, Artificial Sequence
  derived and/or modified CDS sequence (opt2) from DENV-1__GQ868535__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucgccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaugggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10733 - RNA, 9879 nt, Artificial Sequence
  derived and/or modified CDS sequence (opt2) from DENV-1__KJ189306__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggccccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguuccacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucauccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10734 - RNA, 9879 nt, Artificial Sequence
  derived and/or modified CDS sequence (opt2) from DENV-1__KJ189307__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccccgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaagaacgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10735 - RNA, 9879 nt, Artificial Sequence
  derived and/or modified CDS sequence (opt2) from DENV-1__KJ189318__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaagaccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10736 - RNA, 9879 nt, Artificial Sequence
  derived and/or modified CDS sequence (opt2) from DENV-1__KJ189319__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10737 - RNA, 9879 nt, Artificial Sequence
  derived and/or modified CDS sequence (opt2) from DENV-1__KJ189320__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaccgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10738 - RNA, 9879 nt, Artificial Sequence
  derived and/or modified CDS sequence (opt2) from DENV-1__KJ189323__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggccccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccagggcggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgagguccgccccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10739 - RNA, 9879 nt, Artificial Sequence
  derived and/or modified CDS sequence (opt2) from DENV-1__KJ189324__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgaggagaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10740 - RNA, 9879 nt, Artificial Sequence
  derived and/or modified CDS sequence (opt2) from DENV-1__KJ189325__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaccaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaucacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10741 - RNA, 9879 nt, Artificial Sequence
  derived and/or modified CDS sequence (opt2) from DENV-1__KJ189326__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaccaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggccucuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10742 - RNA, 9879 nt, Artificial Sequence
  derived and/or modified CDS sequence (opt2) from DENV-1__KJ189327__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacacccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10743 - RNA, 9879 nt, Artificial Sequence
  derived and/or modified CDS sequence (opt2) from DENV-1__KJ189328__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaaggaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccacccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccaucgaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccucaaggagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10744 - RNA, 9879 nt, Artificial Sequence
  derived and/or modified CDS sequence (opt2) from DENV-1__KJ189329__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacgccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgcuccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucaccucccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuaccgcaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10745 - RNA, 9879 nt, Artificial Sequence
  derived and/or modified CDS sequence (opt2) from DENV-1__KJ189331__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaucggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaagaccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgccaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10746 - RNA, 9879 nt, Artificial Sequence
  derived and/or modified CDS sequence (opt2) from DENV-1__KJ189332__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaccaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaagaccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgccaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10747 - RNA, 9879 nt, Artificial Sequence
  derived and/or modified CDS sequence (opt2) from DENV-1__KJ189334__SS-prME
uccgucaccaugcuccucaugcuccuccccaccgcccucgccuuccaccucaccacccgcggcggcgagccccacaugaucgucuccaagcaggagcgcggcaagucccuccucuucaaggucuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaagaacgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10748 - RNA, 9879 nt, Artificial Sequence
  derived and/or modified CDS sequence (opt2) from DENV-1__KJ189335__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaagaacgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10749 - RNA, 9879 nt, Artificial Sequence
  derived and/or modified CDS sequence (opt2) from DENV-1__KJ189336__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcaucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10750 - RNA, 9879 nt, Artificial Sequence
  derived and/or modified CDS sequence (opt2) from DENV-1__KJ189337__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaucuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagcgcaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacgucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10751 - RNA, 9879 nt, Artificial Sequence
  derived and/or modified CDS sequence (opt2) from DENV-1__KJ189340__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccggcggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10752 - RNA, 9879 nt, Artificial Sequence
  derived and/or modified CDS sequence (opt2) from DENV-1__KJ189341__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcggccaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggccccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgucgucggcaucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacacccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaaggaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagcccuccaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcauccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagcuccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10753 - RNA, 9879 nt, Artificial Sequence
  derived and/or modified CDS sequence (opt2) from DENV-1__KJ189343__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucgucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaucggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaagaccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgccaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10754 - RNA, 9879 nt, Artificial Sequence
  derived and/or modified CDS sequence (opt2) from DENV-1__KJ189344__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucgucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10755 - RNA, 9879 nt, Artificial Sequence
  derived and/or modified CDS sequence (opt2) from DENV-1__KJ189346__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagauguccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcgucauggaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuuccucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucaccucccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgccaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaccgcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacauccuccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10756 - RNA, 9879 nt, Artificial Sequence
  derived and/or modified CDS sequence (opt2) from DENV-1__KJ189347__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggccccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucauggccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgagguccgccccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggccgcugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10757 - RNA, 9879 nt, Artificial Sequence
  derived and/or modified CDS sequence (opt2) from DENV-1__KJ189348__SS-prME
uccgucaccaugcuccucaugcuccuccccaccgcccucgccuuccaccucaccacccgcggcggcgagccccacaugaucgucuccaagcacgagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccuccuucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucaacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10758 - RNA, 9879 nt, Artificial Sequence
  derived and/or modified CDS sequence (opt2) from DENV-1__KJ189368__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaacggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggccccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgaguucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgucuucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10759 - RNA, 9879 nt, Artificial Sequence
  derived and/or modified CDS sequence (opt2) from DENV-1__KJ189369__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaagaacgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10760 - RNA, 9879 nt, Artificial Sequence
  derived and/or modified CDS sequence (opt2) from DENV-1__EU482615__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaaguccgaguccgaccccgagggcgcccucugguga

SEQ ID NO: 10761 - RNA, 9879 nt, Artificial Sequence
  derived and/or modified CDS sequence (opt2) from DENV-1__EU482616__SS-prME
uccgucaccaugcuccucaugcuccuccccaccgcccucgccuuccaccucaccacccgcggcggcgagccccacaugaucgucaacaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10762 - RNA, 9879 nt, Artificial Sequence
  derived and/or modified CDS sequence (opt2) from DENV-1__EU482618__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10763 - RNA, 9879 nt, Artificial Sequence
  derived and/or modified CDS sequence (opt2) from DENV-1__EU482619__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10764 - RNA, 9879 nt, Artificial Sequence
  derived and/or modified CDS sequence (opt2) from DENV-1__FJ898433__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgacuccugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaaggaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccacccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucggcaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccucaaggagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10765 - RNA, 9879 nt, Artificial Sequence
  derived and/or modified CDS sequence (opt2) from DENV-1__FJ547088__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccggccgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10766 - RNA, 9879 nt, Artificial Sequence
  derived and/or modified CDS sequence (opt2) from DENV-1__FJ810419__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10767 - RNA, 9879 nt, Artificial Sequence
  derived and/or modified CDS sequence (opt2) from DENV-1__FJ547068__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgccgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10768 - RNA, 9879 nt, Artificial Sequence
  derived and/or modified CDS sequence (opt2) from DENV-1__FJ562104__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10769 - RNA, 9879 nt, Artificial Sequence
  derived and/or modified CDS sequence (opt2) from DENV-1__GQ199857__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10770 - RNA, 9879 nt, Artificial Sequence
  derived and/or modified CDS sequence (opt2) from DENV-1__GQ199858__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccucggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10771 - RNA, 9879 nt, Artificial Sequence
  derived and/or modified CDS sequence (opt2) from DENV-1__GQ199859__SS-prME
uccgucaccaugcuccucaugcuccuccccaccgcccucgccuuccaccucaccacccgcggcggcgagccccacaugaucgucuccaagcacgagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguaccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10772 - RNA, 9879 nt, Artificial Sequence
  derived and/or modified CDS sequence (opt2) from DENV-1__JF937645__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10773 - RNA, 9879 nt, Artificial Sequence
  derived and/or modified CDS sequence (opt2) from DENV-1__FJ850114__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccucccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaccuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagauccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaucuccaugaagcgcuucaagaacgaguccgaccccgagggcgcccucugguga

SEQ ID NO: 10774 - RNA, 9879 nt, Artificial Sequence
  derived and/or modified CDS sequence (opt2) from DENV-1__JN819402__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccaugaccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccucauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaaguccgaguccgaccccgagggcgcccucugguga

SEQ ID NO: 10775 - RNA, 9879 nt, Artificial Sequence
  derived and/or modified CDS sequence (opt2) from DENV-1__FJ850113__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccucauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaaguccgaguccgaccccgagggcgcccucugguga

SEQ ID NO: 10776 - RNA, 9879 nt, Artificial Sequence
  derived and/or modified CDS sequence (opt2) from DENV-1__JF937635__SS-prME
uccgucaccaugcuccucaugcucaugcccaccgcccucgccuuccaccucaccacccgcggcggcgagccccacaugaucgucuccaagcacgagcgcggcaaggcccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggccccccccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10777 - RNA, 9879 nt, Artificial Sequence
  derived and/or modified CDS sequence (opt2) from DENV-1__FJ024483__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuacacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10778 - RNA, 9879 nt, Artificial Sequence
  derived and/or modified CDS sequence (opt2) from DENV-1__EU596504__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcuucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaugccccccgagaagugcgacacccuccucugcgacaucggcgaguccucccccaaccccaccaucgaggagggccgcacccuccgcauccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10779 - RNA, 9879 nt, Artificial Sequence
  derived and/or modified CDS sequence (opt2) from DENV-1__FJ024481__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaugccccccgagaagugcgacacccuccucugcgacaucggcgaguccucccccaaccccaccaucgaggagggccgcacccuccgcauccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10780 - RNA, 9879 nt, Artificial Sequence
  derived and/or modified CDS sequence (opt2) from DENV-1__GQ199872__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgaccacaugaccuccaugaagcgcuucaagaacgaguccgaccccgagggcgcccucugguga

SEQ ID NO: 10781 - RNA, 9879 nt, Artificial Sequence
  derived and/or modified CDS sequence (opt2) from DENV-1__FJ410290__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccucccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgucgucuuccuccuccucaucaugggccagcucaccuggaaggaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuucgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucggcaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccaccaacgccaagugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugcgccgcuucaagaacgaguccgaccccgagggcgcccucugguga

SEQ ID NO: 10782 - RNA, 9879 nt, Artificial Sequence
  derived and/or modified CDS sequence (opt2) from DENV-1__FJ024423__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucgucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaucaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10783 - RNA, 9879 nt, Artificial Sequence
  derived and/or modified CDS sequence (opt2) from DENV-1__FJ547089__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaccauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcguccccgcccgcgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10784 - RNA, 9879 nt, Artificial Sequence
  derived and/or modified CDS sequence (opt2) from DENV-1__FJ024484__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucgucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgcccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucaccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacggcuucuucaugccccccgagaagugcggcacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10785 - RNA, 9879 nt, Artificial Sequence
  derived and/or modified CDS sequence (opt2) from DENV-1__EU596503__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaucggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcauguucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaccggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10786 - RNA, 9879 nt, Artificial Sequence
  derived and/or modified CDS sequence (opt2) from DENV-1__FJ024479__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcuucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccgccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgcccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaccacccccgagggcaucauccccgcccucuucgagcccgagcgcgagaaguccgccgccaucgacggcgagucccgccuccgcggcgagccccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggcccaaggagggcgagcgcaagaagcuccgcccccgcuggcucgacgcccgcaccuacuccgacccccucgcccucggcgaguucaaggaguucggcgccggccgccgcuccggcuccggcgcccucauccucgagaucggcaagcucccccagcaccucccccuccgcgcccagaacggccucgacaaccucgucaugguccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgccaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucuggaccucccagauccuccucaugcgcaccaccugggcccucggcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaaccccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcggccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauggacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucgucgucgacgagaaccaguggaacuccgccaaggaggccggcgaggacgagcgcgucugggaccucggcgaccgcgagcgcgagcuccacaagcagggcaagugcgccaccugcggcuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgcccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcaggucgccuucuggucccaccacuuccaccagcucaucaugaaggacggccgcgagaucgucguccccugccgcaaccaggacgagcucggcggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10787 - RNA, 9879 nt, Artificial Sequence
  derived and/or modified CDS sequence (opt2) from DENV-1__FJ182002__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaccggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcacccagaccaaggagggcgaccaguacgucuacaugggccagccccucaacaacgacgaggaccacgcccacuggaccgaggccaagaugcuccucgccaacaucaacacccccgagggcaucauccccgcccucuucgagcccgagcgcgagaagucccccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugguucgacggcgagcgcaacaaccagguccucgaggagaacauggacgucgagaucuggaccaaggagggcgagcgcaagaagcuccgcccccgcuggcucgacgcccgcaccuacuccgacccccucgcccucggcgaguucaaggaguucggcgccggccgccgcuccggcuccggcgaccucauccucgagaucggcaagcucccccagcaccucacccuccgcgcccagaacggccucgacaaccucgucaugguccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccggcgaggacgagcgcgucugggaccucgucgaccgcgagcgcgagcuccacaagcagggcaaguggggcaccggcggcuacaacaugaugggcaagcgcgagaagaagcucggcgaguucggcaaggccaagggcucccgcggcaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcaugcccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucuggucccaccacuuccaccagcucaucaugaaggacggccgcgagaucgucguccccugccgcaaccaggacgagcucgucggccgcgcccgcgucucccagggcgccggcuggucccuccgcgagaccgccuggcucggcaaguccuacgcccagaugggccagcucauguacuuccaccgccgcgaccuccgccucgccgccaacgccaucugguccgccggccccggcgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10788 - RNA, 9879 nt, Artificial Sequence
  derived and/or modified CDS sequence (opt2) from DENV-1__FJ024482__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggcccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugguccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuuccucauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgcccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgccaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10789 - RNA, 9879 nt, Artificial Sequence
  derived and/or modified CDS sequence (opt2) from DENV-1__EU596501__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccuccucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccucgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccucccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10790 - RNA, 9879 nt, Artificial Sequence
  derived and/or modified CDS sequence (opt2) from DENV-1__FJ898437__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgucaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10791 - RNA, 9879 nt, Artificial Sequence
  derived and/or modified CDS sequence (opt2) from DENV-1__FJ024480__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucauggccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10792 - RNA, 9879 nt, Artificial Sequence
  derived and/or modified CDS sequence (opt2) from DENV-1__FJ873814__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucgucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaucaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggaguccauccccauggccaccuacgccuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10793 - RNA, 9879 nt, Artificial Sequence
  derived and/or modified CDS sequence (opt2) from DENV-1__JN819403__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgagggccccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10794 - RNA, 9879 nt, Artificial Sequence
  derived and/or modified CDS sequence (opt2) from DENV-1__KF973453__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10795 - RNA, 9879 nt, Artificial Sequence
  derived and/or modified CDS sequence (opt2) from DENV-1__KF973454__SS-prME
uccgucaccaugcuccucaugcuccuccccaccgcccucgccuuccaccucaccacccgcggcggcgagccccacaugaucgucuccaagcacgagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucgcccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagcuccgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuuccccaucugccucuccaccaccucccagaagaccaccuggcuccccguccuccucggcuccuucggcugcaagccccucaccauguaccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccaguccgcccucgacaaccucgucaugcuccacaacuccgagcagggcggcaaggccuaccgccacgccauggaggagcuccccgacaccaucgagacccucaugcuccucgcccucaucgccguccucaccggcggcgucaugcucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucaccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcguccucugguga

SEQ ID NO: 10796 - RNA, 9879 nt, Artificial Sequence
  derived and/or modified CDS sequence (opt2) from DENV-1__KF973455__SS-prME
uccgucaccaugcuccucaugcuccuccccaccgcccucgccuuccaccucaccacccgcggcggcgagccccacaugaucgucuccaagcacgagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucgcccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagcuccgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuuccccaucugccucuccaccaccucccagaagaccaccuggcuccccguccuccucggcuccuucggcugcaagccccucaccauguaccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucaugcucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucaccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10797 - RNA, 9879 nt, Artificial Sequence
  derived and/or modified CDS sequence (opt2) from DENV-1__KF973456__SS-prME
uccgucaccaugcuccucaugcuccuccccaccgcccucgccuuccaccucaccacccgcggcggcgagccccacaugaucgucuccaagcacgagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucgcccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagcuccgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuuccccaucugccucuccaccaccucccagaagaccaccuggcuccccguccuccucggcuccuucggcugcaagccccucaccauguaccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucaugcucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucaccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10798 - RNA, 9879 nt, Artificial Sequence
  derived and/or modified CDS sequence (opt2) from DENV-1__KF973459__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacucccucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggucucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10799 - RNA, 9879 nt, Artificial Sequence
  derived and/or modified CDS sequence (opt2) from DENV-1__KF973460__SS-prME
uccgucaccaugcuccucaugcuccuccccaccgcccucgccuuccaccucaccacccgcggcggcgagccccacaugaucgucuccaagcacgagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucgcccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacucccucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagcuccgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguacuucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaucucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgaguccuaccucgacuacaugaccuccaugaagcgcuucaagaacgaguccgaccccgagggcgcccucugguga

SEQ ID NO: 10800 - RNA, 9879 nt, Artificial Sequence
  derived and/or modified CDS sequence (opt2) from DENV-1__KF973461__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaugggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgagcucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaucaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10801 - RNA, 9879 nt, Artificial Sequence
  derived and/or modified CDS sequence (opt2) from DENV-1__KF973462__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccagaucaucgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggagauggccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggucucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucguccgccuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagauccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10802 - RNA, 9879 nt, Artificial Sequence
  derived and/or modified CDS sequence (opt2) from DENV-1__KF973463__SS-prME
uccgucaccaugcuccucaugcucaugcccaccgcccucgccuuccaccucaccacccgcggcggcgagccccacaugaucgucuccaagcacgagcgcggcaaggcccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagaagaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10803 - RNA, 9879 nt, Artificial Sequence
  derived and/or modified CDS sequence (opt2) from DENV-1__KF973464__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaucuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10804 - RNA, 9879 nt, Artificial Sequence
  derived and/or modified CDS sequence (opt2) from DENV-1__KF973465__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaugggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgagcucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10805 - RNA, 9879 nt, Artificial Sequence
  derived and/or modified CDS sequence (opt2) from DENV-1__KF973466__SS-prME
uccgucaccaugcuccucaugcucaugcccaccgcccucgccuuccaccucaccacccgcggcggcgagccccacaugaucgucuccaagcacgagcgcggcaaggcccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10806 - RNA, 9879 nt, Artificial Sequence
  derived and/or modified CDS sequence (opt2) from DENV-1__KF973471__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccccgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaccgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccgucgaggagggccgcacccuccgcguccucaagauggucgagcccuggcucaagggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10807 - RNA, 9879 nt, Artificial Sequence
  derived and/or modified CDS sequence (opt2) from DENV-1__KF973472__SS-prME
uccgucaccaugcuccucaugcuccuccccaccgcccucgccuuccaccucaccacccgcggcggcgagccccacaugaucgucuccaagcacgagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucgcccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccgucaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagcuccgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucauccgcaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguacuucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccgcgacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgaguccuaccucgacuacaugaccuccaugaagcgcuucaagaacgaguccgaccccgagggcgcccucugguga

SEQ ID NO: 10808 - RNA, 9879 nt, Artificial Sequence
  derived and/or modified CDS sequence (opt2) from DENV-1__KF973474__SS-prME
uccgucaccaugcuccucaugcuccuccccaccgcccucgccuuccaccucaccacccgcggcggcgagccccacaugaucgucuccaagcacgagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucgcccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagcuccgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguaccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccguccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucaccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10809 - RNA, 9879 nt, Artificial Sequence
  derived and/or modified CDS sequence (opt2) from DENV-1__KF973475__SS-prME
uccgucaccaugcuccucaugcucaugcccaccgcccucgccuuccaccucaccacccgcggcggcgagccccacaugaucgucuccaagcacgagcgcggcaaggcccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggcauccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10810 - RNA, 9879 nt, Artificial Sequence
  derived and/or modified CDS sequence (opt2) from DENV-1__FJ898448__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaccgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10811 - RNA, 9879 nt, Artificial Sequence
  derived and/or modified CDS sequence (opt2) from DENV-1__GQ868602__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucaucaccgccaaccccaucgucaccgacaaggagaagcccgucaacaucgaggccgagccccccuucggcgaguccuaccucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucaacggcguccucgcccagggcaagaagaugauccgcccccagcccauggagcacaaguacuccuggaaguccuggggcaaggccaaggucaucggcgccgacguccagaacaucaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucacccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucggccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccacccuccucucccucaccuucgucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggcaagucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaugggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccauggaggccuucccccaguccaacgccgccauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccuccucaagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagucccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgcaacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaacgaccccgagggcgcccucugguga

SEQ ID NO: 10812 - RNA, 9879 nt, Artificial Sequence
  derived and/or modified CDS sequence (opt2) from DENV-1__KF921911__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggaaccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucucccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucuaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10813 - RNA, 9879 nt, Artificial Sequence
  derived and/or modified CDS sequence (opt2) from DENV-1__KJ189350__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaacggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10814 - RNA, 9879 nt, Artificial Sequence
  derived and/or modified CDS sequence (opt2) from DENV-1__KJ189351__SS-prME
uccgucaccaugcuccucaugcuccuccccaccguccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggacccccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucgccgagaaccgcaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcgucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaaguccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10815 - RNA, 9879 nt, Artificial Sequence
  derived and/or modified CDS sequence (opt2) from DENV-1__KJ189352__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaaggucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10816 - RNA, 9879 nt, Artificial Sequence
  derived and/or modified CDS sequence (opt2) from DENV-1__KJ189353__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgagcucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10817 - RNA, 9879 nt, Artificial Sequence
  derived and/or modified CDS sequence (opt2) from DENV-1__KJ189354__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagaaguucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10818 - RNA, 9879 nt, Artificial Sequence
  derived and/or modified CDS sequence (opt2) from DENV-1__KJ189355__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaucgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaugucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucggcuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10819 - RNA, 9879 nt, Artificial Sequence
  derived and/or modified CDS sequence (opt2) from DENV-1__KJ189358__SS-prME
uccgucaccaugcuccucaugcuccuccccaccguccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccacccaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagcccuaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagcgcaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgcaaguaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccagcucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagaacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10820 - RNA, 9879 nt, Artificial Sequence
  derived and/or modified CDS sequence (opt2) from DENV-1__KJ189359__SS-prME
uccgucaccaugcuccucaugcuccuccccaccguccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagcgcaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacaccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagaucgacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacaccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10821 - RNA, 9879 nt, Artificial Sequence
  derived and/or modified CDS sequence (opt2) from DENV-1__KJ189360__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10822 - RNA, 9879 nt, Artificial Sequence
  derived and/or modified CDS sequence (opt2) from DENV-1__KJ189361__SS-prME
uccgucaccaugcuccucaugcuccuccccaccgccauggccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10823 - RNA, 9879 nt, Artificial Sequence
  derived and/or modified CDS sequence (opt2) from DENV-1__KJ189362__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcaugacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucguccgcaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10824 - RNA, 9879 nt, Artificial Sequence
  derived and/or modified CDS sequence (opt2) from DENV-1__KJ189363__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucauggucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10825 - RNA, 9879 nt, Artificial Sequence
  derived and/or modified CDS sequence (opt2) from DENV-1__KJ189364__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcaugacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucguccgcaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10826 - RNA, 9879 nt, Artificial Sequence
  derived and/or modified CDS sequence (opt2) from DENV-1__KJ189365__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgucgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgacgagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10827 - RNA, 9879 nt, Artificial Sequence
  derived and/or modified CDS sequence (opt2) from DENV-1__KJ189366__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucgccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacuccgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgucaccaugcucgacgucgaccuccaccccgccuccgccuggacccucuacgccgucgccaccaccgucaucacccccaugaugcgccacaccaucgagaacgccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccgucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccgucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcgucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10828 - RNA, 9879 nt, Artificial Sequence
  derived and/or modified CDS sequence (opt2) from DENV-1__JN819417__SS-prME
uccgucaccaugcuccucaugcuccuccccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccagcacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccacgagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccuccggcauccucgcccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucaugggcaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgagaucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccaucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucaccaagaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaacgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10829 - RNA, 9879 nt, Artificial Sequence
  derived and/or modified CDS sequence (opt2) from DENV-1__FJ687426__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgccggcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 10830 - RNA, 9879 nt, Artificial Sequence
  derived and/or modified CDS sequence (opt2) from DENV-1__FJ687428__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgccggcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgaguccaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 10831 - RNA, 9879 nt, Artificial Sequence
  derived and/or modified CDS sequence (opt2) from DENV-1__FJ687429__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccuggaucgacgucguccucgagcacggcuccugcaucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 10832 - RNA, 9879 nt, Artificial Sequence
  derived and/or modified CDS sequence (opt2) from DENV-1__FJ850068__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgccggcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 10833 - RNA, 9879 nt, Artificial Sequence
  derived and/or modified CDS sequence (opt2) from DENV-1__FJ687430__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccauccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgcccucgaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccuccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaccgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10834 - RNA, 9879 nt, Artificial Sequence
  derived and/or modified CDS sequence (opt2) from DENV-1__FJ687432__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccaccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccauccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgcccucgaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccuccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaccgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10835 - RNA, 9879 nt, Artificial Sequence
  derived and/or modified CDS sequence (opt2) from DENV-1__JQ922547__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgcccccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacugcgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccacccacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagaugcucgaggccaccgcccgcggcgcccgccgcauggccauccucggcgacaccgccugggacuucggcuccaucggcggcgucuucaccuccaugggcaagcucguccaccaggucuucggcaccgccuacggcguccucuucuccggcgucuccuggaccaugaagaucggcaucggcauccuccucaccuggcucggccucaacucccgcaacaccucccucuccaugaugugcaucgccgucggcauggucacccucuaccucggcgucaugguccaggccgacuccggcugcgucaucaacuggaagggccgcgagcuccucugcggcaccggcaucuucgucaccaacgagguccacaccuggaccgaccccuacaaguuccaggccgaccccuccaaccgccucucccccaucaucggcaaggccugcgucauccgcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcgagaagaugauccgcccccagcccauggagcacaaguacuccuggaaguccuggggcaaggccaagaucaucggcgccgacguccagaacaccaccuucaucaucgacggccccaacacccccgagugccccgacaaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgacuucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggacaaggaggagaaccucgucaaguccauggucuccgccggcuccggcgaggucgacuccuucucccucggccuccucugcaucuccaucaugaucgaggaggucaugcgcucccgcugguccaagaagaugcucauggucggcacccucgccgucuuccuccuccucaucaugggccagcucaccugguccgaccucauccgccucugcaucauggucggcgccaacgccuccgaccgcaugggcaugggcaccaccuaccucgcccucauggccaccuucaagaugcgccccauguucgccgucggccuccucuuccccaagcucaccucccgcgagguccuccuccucaccaucggccucucccucgucgccuccgucgagcuccccuccucccucgaggagcucggcgacggccucgccaagggcaucaugaugcucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccuccccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucgucgccugcuacgucaucuccggcuccuccgccgaccucucccucgagaaggccgccgaggucuccugggaggaggaggccgagcacuccggcgccucccacaacauccucgucgagguccaggacgacggcacccgcaagaucaaggacgaggagcgcgacgacacccucaccauccuccucaaggccacccuccucgccgucuccggcgucuaccccauguccauccccgccacccucuucgucugguacuucuggcagaagaagaaccagcgcuccggcgucggccucaucacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggccgcaaccccaagaacguccagaccgcccccggcaccuucaagacccccgagggcgaggucggcgccaucccccucgacuucaagcccggcaccuccggcucccccaucgucaaccgcgagggcaagaucgucggccucuacggcaacggcgucgucaccaccuccggcaccuacgucuccgccaucgcccgcgccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcguccccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccacccccaccggcuccgucgaggccuucccccaguccaacgccaucauccaggacgaggagcgcgacauccccgagcgcuccuggaacuccggcuacgacuggaucaccgacuuccccggcaagaccgucugguucguccccuccaucaaguccggcaacgacaucgccaacugccucaagaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagcccuccaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacaaggacgucgagaucuggaccaaggagggcgagcgcaagaagcuccgcaccugcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaaggcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaagaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucucccgcauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgccaucucccgccgcgaccagcgcggcuccggccaggucggcaccuacggccucaacaccuuccuccacaaggaggcccagcucauccgccagauggaguucgagggcaucuuccuccccuccgagcucgagacccccaaccucgccggccgcguccucgacuggcucgagcaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggggcgacuggcagcagguccccuucugcucccaccacuuccaccagcucaucaugaaggacguccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10836 - RNA, 9879 nt, Artificial Sequence
  derived and/or modified CDS sequence (opt2) from DENV-1__EU482567__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucauccucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucgucguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacgccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaaggaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaacaccacccucucccucgacuacgccuggcgcaccauggccaugguccucuccaucaucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggcccgcgagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucuggaaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgagcgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10837 - RNA, 9879 nt, Artificial Sequence
  derived and/or modified CDS sequence (opt2) from DENV-1__FJ390378__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucaacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10838 - RNA, 9879 nt, Artificial Sequence
  derived and/or modified CDS sequence (opt2) from DENV-1__FJ205872__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccgcccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucaacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10839 - RNA, 9879 nt, Artificial Sequence
  derived and/or modified CDS sequence (opt2) from DENV-1__FJ205873__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgcaagcucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaaggucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucaacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10840 - RNA, 9879 nt, Artificial Sequence
  derived and/or modified CDS sequence (opt2) from DENV-1__FJ390379__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggccgcaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10841 - RNA, 9879 nt, Artificial Sequence
  derived and/or modified CDS sequence (opt2) from DENV-1__FJ390380__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgagcucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgucgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccaccuucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucaacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10842 - RNA, 9879 nt, Artificial Sequence
  derived and/or modified CDS sequence (opt2) from DENV-1__FJ205874__SS-prME
uccgucaccaugcuccucaugcuccuccccaccguccucgccuuccaccucaccacccgcggcggcgagccccacaugaucgucggcaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagaucccccucuccacccaggacgagaagggcgucacccagaacggccgccucaucaccgccaaccccaucgucaccgacaaggagaagcccgucaacaucgagaccgagccccccuucggcgaguccuacaucaucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccgccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcguccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggcgccucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugccucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccgucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccugguccuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugaagcgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucaugcucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgucaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgccgccacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucggcaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucugggacuuccucucccgcaacaagaagccccgcaucugcacccgcgaggaguucauccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagaccaccaaccucgccgagcgcguccucgacuggcucgagaagcacggcgucgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10843 - RNA, 9879 nt, Artificial Sequence
  derived and/or modified CDS sequence (opt2) from DENV-1__FJ205875__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcugguccaagaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccugguccaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcuggcucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugguccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgacggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10844 - RNA, 9879 nt, Artificial Sequence
  derived and/or modified CDS sequence (opt2) from DENV-1__FJ410173__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccaccuucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucaacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10845 - RNA, 9879 nt, Artificial Sequence
  derived and/or modified CDS sequence (opt2) from DENV-1__FJ410174__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccaucgccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaucaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccgcccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggaggccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10846 - RNA, 9879 nt, Artificial Sequence
  derived and/or modified CDS sequence (opt2) from DENV-1__FJ410175__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10847 - RNA, 9879 nt, Artificial Sequence
  derived and/or modified CDS sequence (opt2) from DENV-1__FJ562105__SS-prME
uccgucaccaugcuccucaugcuccuccccaccguccucgccuuccaccucaccacccgcggcggcgagccccacaugaucgucggcaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagaucccccucuccacccaggacgagaagggcgucacccagaacggccgccucaucaccgccaaccccaucgucaccgacaaggagaagcccgucaacaucgagaccgagccccccuucggcgaguccuacaucaucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccgccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcguccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugccucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccgucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucaugcucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgucaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcucggcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucggcaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucugggacuuccucucccgcaacaagaagccccgcaucugcacccgcgaggaguucauccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagaccaccaaccucgccgagcgcguccucgacuggcucgagaagcacggcgucgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10848 - RNA, 9879 nt, Artificial Sequence
  derived and/or modified CDS sequence (opt2) from DENV-1__FJ562106__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucauggucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccgccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaagaacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucggccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccaccuucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccugcgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccacccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10849 - RNA, 9879 nt, Artificial Sequence
  derived and/or modified CDS sequence (opt2) from DENV-1__FJ410179__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10850 - RNA, 9879 nt, Artificial Sequence
  derived and/or modified CDS sequence (opt2) from DENV-1__FJ410181__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucuaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10851 - RNA, 9879 nt, Artificial Sequence
  derived and/or modified CDS sequence (opt2) from DENV-1__FJ547086__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucauggucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccgccucccucuccaugaccugcaucgccgucggcauggucacccucuaccucggcgucaugguccaggccgacuccggcugcgccaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccagcagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccugcgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccaaccccgagggcgcccucugguga

SEQ ID NO: 10852 - RNA, 9879 nt, Artificial Sequence
  derived and/or modified CDS sequence (opt2) from DENV-1__FJ410183__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgagauggacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgccgagucccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10853 - RNA, 9879 nt, Artificial Sequence
  derived and/or modified CDS sequence (opt2) from DENV-1__FJ410184__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagcgcgaggagaaccucgucaaguccauggucuccgccggccucggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcgccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcucccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10854 - RNA, 9879 nt, Artificial Sequence
  derived and/or modified CDS sequence (opt2) from DENV-1__FJ410185__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgaggagaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10855 - RNA, 9879 nt, Artificial Sequence
  derived and/or modified CDS sequence (opt2) from DENV-1__FJ547087__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucauggucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccgccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggacggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucaccauccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccugcgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10856 - RNA, 9879 nt, Artificial Sequence
  derived and/or modified CDS sequence (opt2) from DENV-1__FJ410186__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucaucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccgccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggccucuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggcccgcgccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccgaccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaucuccaugaagcgcuucaagaacgaguccgaccccgagggcgcccucugguga

SEQ ID NO: 10857 - RNA, 9879 nt, Artificial Sequence
  derived and/or modified CDS sequence (opt2) from DENV-1__FJ410187__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10858 - RNA, 9879 nt, Artificial Sequence
  derived and/or modified CDS sequence (opt2) from DENV-1__FJ478457__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccagcacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcauguucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccuccggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugcuccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucaucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacaugcucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccaggucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagaaguucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgaguggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10859 - RNA, 9879 nt, Artificial Sequence
  derived and/or modified CDS sequence (opt2) from DENV-1__FJ410188__SS-prME
uccgucaccaugcuccucaugcuccuccccaccguccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccagcacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcauguucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccuccggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugcuccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucaucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacaugcucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccaggucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagaaguucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgaguggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10860 - RNA, 9879 nt, Artificial Sequence
  derived and/or modified CDS sequence (opt2) from DENV-1__FJ478458__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgccucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10861 - RNA, 9879 nt, Artificial Sequence
  derived and/or modified CDS sequence (opt2) from DENV-1__FJ410190__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgaggagaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccagcagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10862 - RNA, 9879 nt, Artificial Sequence
  derived and/or modified CDS sequence (opt2) from DENV-1__EU482591__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacuccauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10863 - RNA, 9879 nt, Artificial Sequence
  derived and/or modified CDS sequence (opt2) from DENV-1__EU482592__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacuccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccgcccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcaccgcuacuccuggaaguccuggggcaaggccaagaucaucggcgccgacauccagaacuccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggcgcaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggaggaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccagcaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccugguacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucaacuggcucgagaagcacggcaccgagcgccucaagcgcauggccaucuccggcgacgacugcgucgucaagcccgucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10864 - RNA, 9879 nt, Artificial Sequence
  derived and/or modified CDS sequence (opt2) from DENV-1__EU482609__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggcccgcgccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10865 - RNA, 9879 nt, Artificial Sequence
  derived and/or modified CDS sequence (opt2) from DENV-1__EU482610__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccuggguccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10866 - RNA, 9879 nt, Artificial Sequence
  derived and/or modified CDS sequence (opt2) from DENV-1__EU482611__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10867 - RNA, 9879 nt, Artificial Sequence
  derived and/or modified CDS sequence (opt2) from DENV-1__FJ639735__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucgucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10868 - RNA, 9879 nt, Artificial Sequence
  derived and/or modified CDS sequence (opt2) from DENV-1__FJ639740__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucgccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggaggccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10869 - RNA, 9879 nt, Artificial Sequence
  derived and/or modified CDS sequence (opt2) from DENV-1__FJ639741__SS-prME
uccgucaccauccuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcaccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgccaaggccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccucggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucuggaaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10870 - RNA, 9879 nt, Artificial Sequence
  derived and/or modified CDS sequence (opt2) from DENV-1__FJ639743__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucauggcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagguccgcuacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaaggucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggccgcaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugucccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggaggccaaccucgacaucaucggccagcgcaucgagaacauccgcaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10871 - RNA, 9879 nt, Artificial Sequence
  derived and/or modified CDS sequence (opt2) from DENV-1__FJ639794__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgucgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaaccucggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugguccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucgucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10872 - RNA, 9879 nt, Artificial Sequence
  derived and/or modified CDS sequence (opt2) from DENV-1__FJ639796__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10873 - RNA, 9879 nt, Artificial Sequence
  derived and/or modified CDS sequence (opt2) from DENV-1__FJ639797__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10874 - RNA, 9879 nt, Artificial Sequence
  derived and/or modified CDS sequence (opt2) from DENV-1__FJ639802__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguaccgcuuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10875 - RNA, 9879 nt, Artificial Sequence
  derived and/or modified CDS sequence (opt2) from DENV-1__JN819410__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcaaccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10876 - RNA, 9879 nt, Artificial Sequence
  derived and/or modified CDS sequence (opt2) from DENV-1__FJ639806__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucaagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10877 - RNA, 9879 nt, Artificial Sequence
  derived and/or modified CDS sequence (opt2) from DENV-1__JN819411__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaagcucaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10878 - RNA, 9879 nt, Artificial Sequence
  derived and/or modified CDS sequence (opt2) from DENV-1__FJ639812__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugaugcuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccuccuccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10879 - RNA, 9879 nt, Artificial Sequence
  derived and/or modified CDS sequence (opt2) from DENV-1__FJ639813__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaugaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccuccuucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccaugcccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacuccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10880 - RNA, 9879 nt, Artificial Sequence
  derived and/or modified CDS sequence (opt2) from DENV-1__JN819412__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccuccuccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10881 - RNA, 9879 nt, Artificial Sequence
  derived and/or modified CDS sequence (opt2) from DENV-1__FJ810415__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcgucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucaacugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10882 - RNA, 9879 nt, Artificial Sequence
  derived and/or modified CDS sequence (opt2) from DENV-1__FJ639814__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10883 - RNA, 9879 nt, Artificial Sequence
  derived and/or modified CDS sequence (opt2) from DENV-1__FJ639815__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugcuccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10884 - RNA, 9879 nt, Artificial Sequence
  derived and/or modified CDS sequence (opt2) from DENV-1__FJ639818__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggagaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccacccaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10885 - RNA, 9879 nt, Artificial Sequence
  derived and/or modified CDS sequence (opt2) from DENV-1__FJ639819__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacaacuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccugcgucaagaaggaccucaucuccuacggcggcggcuggcgcuuccagggccucuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10886 - RNA, 9879 nt, Artificial Sequence
  derived and/or modified CDS sequence (opt2) from DENV-1__FJ639820__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgccaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10887 - RNA, 9879 nt, Artificial Sequence
  derived and/or modified CDS sequence (opt2) from DENV-1__FJ639821__SS-prME
uccgccaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagguccgcuacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuacacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacaacuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacggcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgacaaggccgccgaggucuccugggagcaggaggccgagcacuccggcgccucccacaacaucuccgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccugcgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgucaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaaccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucaccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10888 - RNA, 9879 nt, Artificial Sequence
  derived and/or modified CDS sequence (opt2) from DENV-1__FJ639824__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucgucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10889 - RNA, 9879 nt, Artificial Sequence
  derived and/or modified CDS sequence (opt2) from DENV-1__JN819425__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgucaagaucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10890 - RNA, 9879 nt, Artificial Sequence
  derived and/or modified CDS sequence (opt2) from DENV-1__FJ850099__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccucuccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10891 - RNA, 9879 nt, Artificial Sequence
  derived and/or modified CDS sequence (opt2) from DENV-1__FJ850100__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccacccaccucgcccucauggccaccuucaagaugcgccccauguucgccgucggccuccucuuccgccgccucaccucccgcgagguccuccuccucaccaucggccucucccucauggccuccauggagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugauccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccacccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10892 - RNA, 9879 nt, Artificial Sequence
  derived and/or modified CDS sequence (opt2) from DENV-1__FJ882579__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccuccuccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10893 - RNA, 9879 nt, Artificial Sequence
  derived and/or modified CDS sequence (opt2) from DENV-1__JN819414__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgccuacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccuccuccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccggcggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacaccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10894 - RNA, 9879 nt, Artificial Sequence
  derived and/or modified CDS sequence (opt2) from DENV-1__FJ873810__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10895 - RNA, 9879 nt, Artificial Sequence
  derived and/or modified CDS sequence (opt2) from DENV-1__FJ850103__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaguccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10896 - RNA, 9879 nt, Artificial Sequence
  derived and/or modified CDS sequence (opt2) from DENV-1__FJ850104__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgucaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggaggccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10897 - RNA, 9879 nt, Artificial Sequence
  derived and/or modified CDS sequence (opt2) from DENV-1__JN819405__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccacccaccucgcccucauggccaccuucaagaugcgccccauguucgccgucggccuccucuuccgccgccucaccucccgcgagguccuccuccucaccaucggccucucccucauggccuccauggagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugauccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagaccaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaacuucaccgaggucaagggcuacaccuccggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10898 - RNA, 9879 nt, Artificial Sequence
  derived and/or modified CDS sequence (opt2) from DENV-1__GQ199877__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccuccucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10899 - RNA, 9879 nt, Artificial Sequence
  derived and/or modified CDS sequence (opt2) from DENV-1__GU056029__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucguccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccgcccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10900 - RNA, 9879 nt, Artificial Sequence
  derived and/or modified CDS sequence (opt2) from DENV-1__GU056030__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagguccgcuacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuacacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacaacuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacggcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgacaaggccgccgaggucuccugggagcaggaggccgagcacuccggcgccucccacaacaucuccgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccugcgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgucaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaaccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucaccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10901 - RNA, 9879 nt, Artificial Sequence
  derived and/or modified CDS sequence (opt2) from DENV-1__GU056031__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagcccuccaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgaccccgagggcgcccucugguga

SEQ ID NO: 10902 - RNA, 9879 nt, Artificial Sequence
  derived and/or modified CDS sequence (opt2) from DENV-1__GU056032__SS-prME
uccgucgccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccaugcuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagauccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacaccgagggcgcccucugguga

SEQ ID NO: 10903 - RNA, 9879 nt, Artificial Sequence
  derived and/or modified CDS sequence (opt2) from DENV-1__GU056033__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgccaaggccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcaucucccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagucccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagaccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccucggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucuggaaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10904 - RNA, 9879 nt, Artificial Sequence
  derived and/or modified CDS sequence (opt2) from DENV-1__GU131833__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccagaacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaucaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacauggccuccaugaagcgcuucaagaacgaguccgaccccgagggcgcccucugguga

SEQ ID NO: 10905 - RNA, 9879 nt, Artificial Sequence
  derived and/or modified CDS sequence (opt2) from DENV-1__GU131834__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaagacccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguucuucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10906 - RNA, 9879 nt, Artificial Sequence
  derived and/or modified CDS sequence (opt2) from DENV-1__GU131835__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccuggguccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgccgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaugaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucaugcucuucuuccucuccggcaagggccucggcaagaccuccaucggccuccucugcgucaccgccuccuccgcccuccucuggauggccuccgucgagccccacuggaucgccgccuccaucguccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccaccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucucccgcauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccucccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccucgagggcgcccucugguga

SEQ ID NO: 10907 - RNA, 9879 nt, Artificial Sequence
  derived and/or modified CDS sequence (opt2) from DENV-1__GU131836__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucguccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucucccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagguccccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccggccacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10908 - RNA, 9879 nt, Artificial Sequence
  derived and/or modified CDS sequence (opt2) from DENV-1__GU131837__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggaggccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10909 - RNA, 9879 nt, Artificial Sequence
  derived and/or modified CDS sequence (opt2) from DENV-1__JN819415__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10910 - RNA, 9879 nt, Artificial Sequence
  derived and/or modified CDS sequence (opt2) from DENV-1__GU131838__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaagaccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10911 - RNA, 9879 nt, Artificial Sequence
  derived and/or modified CDS sequence (opt2) from DENV-1__GU131839__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaccguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucguccagggcaagaagaugauccgcccccagcccauggagcacaaguacuccuggaaguccuggggcaaggccaagaucaucggcgccgacacccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccgcccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccuccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuuccgcgagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacgucuacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 10912 - RNA, 9879 nt, Artificial Sequence
  derived and/or modified CDS sequence (opt2) from DENV-1__GU131841__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgccuacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10913 - RNA, 9879 nt, Artificial Sequence
  derived and/or modified CDS sequence (opt2) from DENV-1__GQ868601__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucacccgccucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgccgcaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccacccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagcgcguccucgacuggcucgagaagcagggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10914 - RNA, 9879 nt, Artificial Sequence
  derived and/or modified CDS sequence (opt2) from DENV-1__EU660390__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucaucgucggcgacgucgccggcauccucggccagggccgcaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucgucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10915 - RNA, 9879 nt, Artificial Sequence
  derived and/or modified CDS sequence (opt2) from DENV-1__EU660391__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggacggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaaguacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10916 - RNA, 9879 nt, Artificial Sequence
  derived and/or modified CDS sequence (opt2) from DENV-1__EU660393__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcaucacccaguccggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuaccgccgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10917 - RNA, 9879 nt, Artificial Sequence
  derived and/or modified CDS sequence (opt2) from DENV-1__EU660401__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10918 - RNA, 9879 nt, Artificial Sequence
  derived and/or modified CDS sequence (opt2) from DENV-1__FJ373305__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccgucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10919 - RNA, 9879 nt, Artificial Sequence
  derived and/or modified CDS sequence (opt2) from DENV-1__EU660402__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaucgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaagaucuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuacgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucucccacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucaugcucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 10920 - RNA, 9879 nt, Artificial Sequence
  derived and/or modified CDS sequence (opt2) from DENV-1__EU660403__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10921 - RNA, 9879 nt, Artificial Sequence
  derived and/or modified CDS sequence (opt2) from DENV-1__EU660397__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10922 - RNA, 9879 nt, Artificial Sequence
  derived and/or modified CDS sequence (opt2) from DENV-1__EU687247__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaagaucuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucaacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 10923 - RNA, 9879 nt, Artificial Sequence
  derived and/or modified CDS sequence (opt2) from DENV-1__EU660412__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaucuccaugaagcgcuucaagaacgaguccgaccccgagggcgcccucugguga

SEQ ID NO: 10924 - RNA, 9879 nt, Artificial Sequence
  derived and/or modified CDS sequence (opt2) from DENV-1__EU660418__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10925 - RNA, 9879 nt, Artificial Sequence
  derived and/or modified CDS sequence (opt2) from DENV-1__EU677151__SS-prME
uccgucaccaugcuccucaugcucauccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggcgccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauggucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10926 - RNA, 9879 nt, Artificial Sequence
  derived and/or modified CDS sequence (opt2) from DENV-1__EU677152__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10927 - RNA, 9879 nt, Artificial Sequence
  derived and/or modified CDS sequence (opt2) from DENV-1__EU677155__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccggcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10928 - RNA, 9879 nt, Artificial Sequence
  derived and/or modified CDS sequence (opt2) from DENV-1__EU677157__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10929 - RNA, 9879 nt, Artificial Sequence
  derived and/or modified CDS sequence (opt2) from DENV-1__EU677158__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucguccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10930 - RNA, 9879 nt, Artificial Sequence
  derived and/or modified CDS sequence (opt2) from DENV-1__EU677159__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccaucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaucuccaugaagcgcuucaagaacgaguccgaccccgagggcgcccucugguga

SEQ ID NO: 10931 - RNA, 9879 nt, Artificial Sequence
  derived and/or modified CDS sequence (opt2) from DENV-1__EU677160__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucguccucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaagucccucgucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10932 - RNA, 9879 nt, Artificial Sequence
  derived and/or modified CDS sequence (opt2) from DENV-1__EU677162__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggccgcauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10933 - RNA, 9879 nt, Artificial Sequence
  derived and/or modified CDS sequence (opt2) from DENV-1__EU677164__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcaucgccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaacuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccguccucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccacccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10934 - RNA, 9879 nt, Artificial Sequence
  derived and/or modified CDS sequence (opt2) from DENV-1__EU677165__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaucaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgccacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucgcccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10935 - RNA, 9879 nt, Artificial Sequence
  derived and/or modified CDS sequence (opt2) from DENV-1__EU677140__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucaagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10936 - RNA, 9879 nt, Artificial Sequence
  derived and/or modified CDS sequence (opt2) from DENV-1__EU677166__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10937 - RNA, 9879 nt, Artificial Sequence
  derived and/or modified CDS sequence (opt2) from DENV-1__EU677170__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggaugaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccauccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10938 - RNA, 9879 nt, Artificial Sequence
  derived and/or modified CDS sequence (opt2) from DENV-1__EU677171__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10939 - RNA, 9879 nt, Artificial Sequence
  derived and/or modified CDS sequence (opt2) from DENV-1__EU677172__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaccaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10940 - RNA, 9879 nt, Artificial Sequence
  derived and/or modified CDS sequence (opt2) from DENV-1__EU677173__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccaccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacgccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10941 - RNA, 9879 nt, Artificial Sequence
  derived and/or modified CDS sequence (opt2) from DENV-1__EU726779__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10942 - RNA, 9879 nt, Artificial Sequence
  derived and/or modified CDS sequence (opt2) from DENV-1__EU677176__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggccucuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagaccaagcgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagcgcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgacuccgaccccgagggcgcccucugguga

SEQ ID NO: 10943 - RNA, 9879 nt, Artificial Sequence
  derived and/or modified CDS sequence (opt2) from DENV-1__EU726780__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaagacccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggucacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucaucuccgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10944 - RNA, 9879 nt, Artificial Sequence
  derived and/or modified CDS sequence (opt2) from DENV-1__EU726781__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgucgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaacuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccguccucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10945 - RNA, 9879 nt, Artificial Sequence
  derived and/or modified CDS sequence (opt2) from DENV-1__EU726782__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10946 - RNA, 9879 nt, Artificial Sequence
  derived and/or modified CDS sequence (opt2) from DENV-1__EU677178__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacaccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10947 - RNA, 9879 nt, Artificial Sequence
  derived and/or modified CDS sequence (opt2) from DENV-1__EU687251__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucaagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10948 - RNA, 9879 nt, Artificial Sequence
  derived and/or modified CDS sequence (opt2) from DENV-1__FJ024427__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccggcuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcgccgacgcccccugcaagauccccuucuccacccaggacgagaagggcaucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucaaccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10949 - RNA, 9879 nt, Artificial Sequence
  derived and/or modified CDS sequence (opt2) from DENV-1__FJ024428__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10950 - RNA, 9879 nt, Artificial Sequence
  derived and/or modified CDS sequence (opt2) from DENV-1__FJ024429__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccucaugaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaucgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagcgcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10951 - RNA, 9879 nt, Artificial Sequence
  derived and/or modified CDS sequence (opt2) from DENV-1__FJ024430__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccaugcuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgcccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccaccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccgucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10952 - RNA, 9879 nt, Artificial Sequence
  derived and/or modified CDS sequence (opt2) from DENV-1__FJ024433__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaucucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggaaccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10953 - RNA, 9879 nt, Artificial Sequence
  derived and/or modified CDS sequence (opt2) from DENV-1__FJ024434__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguacaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccgccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaucuccaugaagcgcuucaagaacgaguccgaccccgagggcgcccucugguga

SEQ ID NO: 10954 - RNA, 9879 nt, Artificial Sequence
  derived and/or modified CDS sequence (opt2) from DENV-1__FJ024435__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucaucuacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10955 - RNA, 9879 nt, Artificial Sequence
  derived and/or modified CDS sequence (opt2) from DENV-1__FJ024436__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgaguacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggacgagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccaugcucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuacucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgcaaguccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10956 - RNA, 9879 nt, Artificial Sequence
  derived and/or modified CDS sequence (opt2) from DENV-1__FJ024472__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccgucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucaucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10957 - RNA, 9879 nt, Artificial Sequence
  derived and/or modified CDS sequence (opt2) from DENV-1__FJ024439__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccaggccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10958 - RNA, 9879 nt, Artificial Sequence
  derived and/or modified CDS sequence (opt2) from DENV-1__FJ024441__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaccaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10959 - RNA, 9879 nt, Artificial Sequence
  derived and/or modified CDS sequence (opt2) from DENV-1__FJ024442__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggccgcaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaaccucggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10960 - RNA, 9879 nt, Artificial Sequence
  derived and/or modified CDS sequence (opt2) from DENV-1__FJ373296__SS-prME
uccgucaccaugcuccucaugcucaugcccaucgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10961 - RNA, 9879 nt, Artificial Sequence
  derived and/or modified CDS sequence (opt2) from DENV-1__FJ182018__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccaucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10962 - RNA, 9879 nt, Artificial Sequence
  derived and/or modified CDS sequence (opt2) from DENV-1__FJ410287__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccucccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10963 - RNA, 9879 nt, Artificial Sequence
  derived and/or modified CDS sequence (opt2) from DENV-1__FJ432719__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccgccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10964 - RNA, 9879 nt, Artificial Sequence
  derived and/or modified CDS sequence (opt2) from DENV-1__FJ182020__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10965 - RNA, 9879 nt, Artificial Sequence
  derived and/or modified CDS sequence (opt2) from DENV-1__FJ182022__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10966 - RNA, 9879 nt, Artificial Sequence
  derived and/or modified CDS sequence (opt2) from DENV-1__FJ024447__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaaggucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10967 - RNA, 9879 nt, Artificial Sequence
  derived and/or modified CDS sequence (opt2) from DENV-1__FJ182025__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucaucgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccaccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccgucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10968 - RNA, 9879 nt, Artificial Sequence
  derived and/or modified CDS sequence (opt2) from DENV-1__FJ373297__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggccucuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccaaccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgacuccgaccccgagggcgcccucugguga

SEQ ID NO: 10969 - RNA, 9879 nt, Artificial Sequence
  derived and/or modified CDS sequence (opt2) from DENV-1__FJ024448__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaucaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgccuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10970 - RNA, 9879 nt, Artificial Sequence
  derived and/or modified CDS sequence (opt2) from DENV-1__FJ182026__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccagaacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacgccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10971 - RNA, 9879 nt, Artificial Sequence
  derived and/or modified CDS sequence (opt2) from DENV-1__FJ182027__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaucaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10972 - RNA, 9879 nt, Artificial Sequence
  derived and/or modified CDS sequence (opt2) from DENV-1__FJ024449__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgacgucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucaagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10973 - RNA, 9879 nt, Artificial Sequence
  derived and/or modified CDS sequence (opt2) from DENV-1__FJ390383__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgagccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10974 - RNA, 9879 nt, Artificial Sequence
  derived and/or modified CDS sequence (opt2) from DENV-1__FJ182033__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccucggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10975 - RNA, 9879 nt, Artificial Sequence
  derived and/or modified CDS sequence (opt2) from DENV-1__FJ182034__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccaugcucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuacucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10976 - RNA, 9879 nt, Artificial Sequence
  derived and/or modified CDS sequence (opt2) from DENV-1__FJ182036__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgccacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaugucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10977 - RNA, 9879 nt, Artificial Sequence
  derived and/or modified CDS sequence (opt2) from DENV-1__FJ205876__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucaaccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10978 - RNA, 9879 nt, Artificial Sequence
  derived and/or modified CDS sequence (opt2) from DENV-1__FJ024455__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggccccccccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10979 - RNA, 9879 nt, Artificial Sequence
  derived and/or modified CDS sequence (opt2) from DENV-1__FJ024456__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcauccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggcauggaggagcccauccccauggccaccaacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10980 - RNA, 9879 nt, Artificial Sequence
  derived and/or modified CDS sequence (opt2) from DENV-1__FJ024457__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccauccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10981 - RNA, 9879 nt, Artificial Sequence
  derived and/or modified CDS sequence (opt2) from DENV-1__FJ205881__SS-prME
uccgucaccaugcuccuccuccucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10982 - RNA, 9879 nt, Artificial Sequence
  derived and/or modified CDS sequence (opt2) from DENV-1__FJ205882__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggacgagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucuggaaggucgaggaccacggcuucggcaucuuccccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccaugcucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuacucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgcaaguccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10983 - RNA, 9879 nt, Artificial Sequence
  derived and/or modified CDS sequence (opt2) from DENV-1__FJ390388__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccucaugaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagcgcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10984 - RNA, 9879 nt, Artificial Sequence
  derived and/or modified CDS sequence (opt2) from DENV-1__FJ024464__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcguccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaugucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10985 - RNA, 9879 nt, Artificial Sequence
  derived and/or modified CDS sequence (opt2) from DENV-1__FJ410191__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccagcacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaagggcgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucguccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaucgaggcccagcucauccgccagauggaguccgaggagaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10986 - RNA, 9879 nt, Artificial Sequence
  derived and/or modified CDS sequence (opt2) from DENV-1__FJ432723__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucaucgccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccuucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccggcgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10987 - RNA, 9879 nt, Artificial Sequence
  derived and/or modified CDS sequence (opt2) from DENV-1__FJ410192__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagucccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10988 - RNA, 9879 nt, Artificial Sequence
  derived and/or modified CDS sequence (opt2) from DENV-1__FJ410194__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccccuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgagccccgcaucaccgacaucauggagcccgagcacgcccuccucgccaaguccaucuucaagcucaccuaccagaacaaggucguccgcguccagucccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucuggucccaccacuuccaccagcucaucaugaaggacggccgcgagaucgucguccccugccgcaaccaggacgagcucgucggccgcgcccgcgucucccagggcgccggcuggucccuccgcgagaccgccugccucgccaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10989 - RNA, 9879 nt, Artificial Sequence
  derived and/or modified CDS sequence (opt2) from DENV-1__FJ432725__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccggcgucaccggcggcgucacccucgucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgccaagggcuggcccaucuccaagauggacaucggcgucccccuccucgcccucggcugcuacucccaggucaacccccucacccucaccgcccccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcccccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucggccaccgcgagcgcgagcuccacaagcagggcaagugcgccaccugcgucuccaacaugaugggcaagcgcgagaagaagcucggcgaguucggcaagcccaagggcucccgccccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucuccucccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10990 - RNA, 9879 nt, Artificial Sequence
  derived and/or modified CDS sequence (opt2) from DENV-1__FJ432729__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucgccaugcuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccagaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10991 - RNA, 9879 nt, Artificial Sequence
  derived and/or modified CDS sequence (opt2) from DENV-1__FJ432730__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaugaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10992 - RNA, 9879 nt, Artificial Sequence
  derived and/or modified CDS sequence (opt2) from DENV-1__FJ432732__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaccaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcaucuucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10993 - RNA, 9879 nt, Artificial Sequence
  derived and/or modified CDS sequence (opt2) from DENV-1__FJ432733__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucgccaugcuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccagaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10994 - RNA, 9879 nt, Artificial Sequence
  derived and/or modified CDS sequence (opt2) from DENV-1__FJ410196__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuucuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccuccgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcggcaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10995 - RNA, 9879 nt, Artificial Sequence
  derived and/or modified CDS sequence (opt2) from DENV-1__FJ432734__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccuggguccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcauguucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaccgaccccgagggcgcccucugguga

SEQ ID NO: 10996 - RNA, 9879 nt, Artificial Sequence
  derived and/or modified CDS sequence (opt2) from DENV-1__FJ432735__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10997 - RNA, 9879 nt, Artificial Sequence
  derived and/or modified CDS sequence (opt2) from DENV-1__FJ432736__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuaccucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggccccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaucuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10998 - RNA, 9879 nt, Artificial Sequence
  derived and/or modified CDS sequence (opt2) from DENV-1__FJ410198__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10999 - RNA, 9879 nt, Artificial Sequence
  derived and/or modified CDS sequence (opt2) from DENV-1__FJ410199__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaacuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccguccucuuccuccucaucaugggccagcucaccugguccgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgcaaguaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11000 - RNA, 9879 nt, Artificial Sequence
  derived and/or modified CDS sequence (opt2) from DENV-1__FJ432739__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaggccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcauccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaucgaccccgagggcgcccucugguga

SEQ ID NO: 11001 - RNA, 9879 nt, Artificial Sequence
  derived and/or modified CDS sequence (opt2) from DENV-1__FJ410201__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucaacuacaugaccuccaugaagcgcuucaagaacgaguccgaccccgagggcgcccucugguga

SEQ ID NO: 11002 - RNA, 9879 nt, Artificial Sequence
  derived and/or modified CDS sequence (opt2) from DENV-1__FJ410203__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11003 - RNA, 9879 nt, Artificial Sequence
  derived and/or modified CDS sequence (opt2) from DENV-1__FJ410204__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgaggucuacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagaccaagaagcuccgccaccgcuggcccgacgcccgccaguacuccgacccccucggccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11004 - RNA, 9879 nt, Artificial Sequence
  derived and/or modified CDS sequence (opt2) from DENV-1__FJ432742__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11005 - RNA, 9879 nt, Artificial Sequence
  derived and/or modified CDS sequence (opt2) from DENV-1__FJ410205__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11006 - RNA, 9879 nt, Artificial Sequence
  derived and/or modified CDS sequence (opt2) from DENV-1__FJ410207__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucauggucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcucgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaaccgcaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11007 - RNA, 9879 nt, Artificial Sequence
  derived and/or modified CDS sequence (opt2) from DENV-1__FJ432744__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaggccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcauccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcgccgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaucgaccccgagggcgcccucugguga

SEQ ID NO: 11008 - RNA, 9879 nt, Artificial Sequence
  derived and/or modified CDS sequence (opt2) from DENV-1__FJ547060__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucguccgccagauggaguccgagggcaucuucucccccugcgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11009 - RNA, 9879 nt, Artificial Sequence
  derived and/or modified CDS sequence (opt2) from DENV-1__FJ432745__SS-prME
uccgucaccaugcuccucaugcucaugcccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11010 - RNA, 9879 nt, Artificial Sequence
  derived and/or modified CDS sequence (opt2) from DENV-1__FJ432746__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacaccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucguccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11011 - RNA, 9879 nt, Artificial Sequence
  derived and/or modified CDS sequence (opt2) from DENV-1__FJ432748__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagguccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11012 - RNA, 9879 nt, Artificial Sequence
  derived and/or modified CDS sequence (opt2) from DENV-1__FJ432749__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagaaggccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggcguccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgccuucugguga

SEQ ID NO: 11013 - RNA, 9879 nt, Artificial Sequence
  derived and/or modified CDS sequence (opt2) from DENV-1__FJ410212__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcgcccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucgucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga
